United States Patent 11,931,406 (FLAVIVIRUS VACCINE) - sequence listing, part 49

SEQ ID NO: 17994 - RNA, 9873 nt, Artificial Sequence
  derived and/or modified CDS sequence (opt4) from DENV-3__KJ189279__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggugacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccaucaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17995 - RNA, 9873 nt, Artificial Sequence
  derived and/or modified CDS sequence (opt4) from DENV-3__KJ189280__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaaggugagcagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17996 - RNA, 9873 nt, Artificial Sequence
  derived and/or modified CDS sequence (opt4) from DENV-3__KJ189281__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggugcugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17997 - RNA, 9873 nt, Artificial Sequence
  derived and/or modified CDS sequence (opt4) from DENV-3__KJ189282__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagaggccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcauggccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17998 - RNA, 9873 nt, Artificial Sequence
  derived and/or modified CDS sequence (opt4) from DENV-3__KJ189283__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaagaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17999 - RNA, 9873 nt, Artificial Sequence
  derived and/or modified CDS sequence (opt4) from DENV-3__KJ189284__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggugacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18000 - RNA, 9873 nt, Artificial Sequence
  derived and/or modified CDS sequence (opt4) from DENV-3__KJ189286__SS-prME
accagcuucugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18001 - RNA, 9873 nt, Artificial Sequence
  derived and/or modified CDS sequence (opt4) from DENV-3__KJ189287__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagaaacauggcccacacccugaucaugaucggcagcaacgccagcgacagaaugggcaugggcgugaccuaccuggcccugaucgccaccuucaagauccagcccuuccuggugcugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcauggccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18002 - RNA, 9873 nt, Artificial Sequence
  derived and/or modified CDS sequence (opt4) from DENV-3__KJ189288__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagauggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacgugaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagaggccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcuggugcccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18003 - RNA, 9873 nt, Artificial Sequence
  derived and/or modified CDS sequence (opt4) from DENV-3__KJ189289__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagcagcaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaagaccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18004 - RNA, 9873 nt, Artificial Sequence
  derived and/or modified CDS sequence (opt4) from DENV-3__KJ189290__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagaaacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagagaagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18005 - RNA, 9873 nt, Artificial Sequence
  derived and/or modified CDS sequence (opt4) from DENV-3__KJ189291__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagaaacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagagaagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggacccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18006 - RNA, 9873 nt, Artificial Sequence
  derived and/or modified CDS sequence (opt4) from DENV-3__KJ189292__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgaggccgagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucaugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcaucaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccauccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggcagcacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaagaucagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18007 - RNA, 9873 nt, Artificial Sequence
  derived and/or modified CDS sequence (opt4) from DENV-3__KJ189293__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18008 - RNA, 9873 nt, Artificial Sequence
  derived and/or modified CDS sequence (opt4) from DENV-3__KJ189294__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18009 - RNA, 9873 nt, Artificial Sequence
  derived and/or modified CDS sequence (opt4) from DENV-3__KJ189295__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugcugaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacagaacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18010 - RNA, 9873 nt, Artificial Sequence
  derived and/or modified CDS sequence (opt4) from DENV-3__KJ189297__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagccagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18011 - RNA, 9873 nt, Artificial Sequence
  derived and/or modified CDS sequence (opt4) from DENV-3__KJ189298__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagaaacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18012 - RNA, 9873 nt, Artificial Sequence
  derived and/or modified CDS sequence (opt4) from DENV-3__KJ189301__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacgugaagcugaccgugguggugggcgacaucaucggcgugcuggagagaggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagaggccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcuggugcccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18013 - RNA, 9873 nt, Artificial Sequence
  derived and/or modified CDS sequence (opt4) from DENV-3__KF955456__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccuggugaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccauccagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18014 - RNA, 9873 nt, Artificial Sequence
  derived and/or modified CDS sequence (opt4) from DENV-3__KF955465__SS-prME
accagccugugcaucaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagauggugcugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18015 - RNA, 9873 nt, Artificial Sequence
  derived and/or modified CDS sequence (opt4) from DENV-3__KF955466__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaugcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18016 - RNA, 9873 nt, Artificial Sequence
  derived and/or modified CDS sequence (opt4) from DENV-3__KF955468__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauccugacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcagaguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggacccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18017 - RNA, 9873 nt, Artificial Sequence
  derived and/or modified CDS sequence (opt4) from DENV-3__FJ744726__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagaaggacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18018 - RNA, 9873 nt, Artificial Sequence
  derived and/or modified CDS sequence (opt4) from DENV-3__FJ744729__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccugaagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugagaagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18019 - RNA, 9873 nt, Artificial Sequence
  derived and/or modified CDS sequence (opt4) from DENV-3__FJ687448__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18020 - RNA, 9873 nt, Artificial Sequence
  derived and/or modified CDS sequence (opt4) from DENV-3__FJ744732__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18021 - RNA, 9873 nt, Artificial Sequence
  derived and/or modified CDS sequence (opt4) from DENV-3__FJ810414__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggccaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18022 - RNA, 9873 nt, Artificial Sequence
  derived and/or modified CDS sequence (opt4) from DENV-3__FJ744734__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaugggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18023 - RNA, 9873 nt, Artificial Sequence
  derived and/or modified CDS sequence (opt4) from DENV-3__FJ744737__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18024 - RNA, 9873 nt, Artificial Sequence
  derived and/or modified CDS sequence (opt4) from DENV-3__FJ744739__SS-prME
accagccugugccugaugaugaugcugcccgccacccuggccuuccaccugaccagcagagacggcgagcccagaaugaucguggccaagaacgagagaggcaagagccugcuguucaagaccgugagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagcuucaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18025 - RNA, 9873 nt, Artificial Sequence
  derived and/or modified CDS sequence (opt4) from DENV-3__FJ744740__SS-prME
accagccugugccugaugaugaugcugcccgccacccuggccuuccaccugaccagcagagacggcgagcccagaaugaucguggccaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccaucgccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcgugggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcauccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucgugaccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagguggaccuggagaacccccaccugcuggagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18026 - RNA, 9873 nt, Artificial Sequence
  derived and/or modified CDS sequence (opt4) from DENV-3__GQ868593__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugauccuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcgugcugcugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggccacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucaccagacacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucaagaaggaggaggagagcgagggcgccaucugguga

SEQ ID NO: 18027 - RNA, 9873 nt, Artificial Sequence
  derived and/or modified CDS sequence (opt4) from DENV-3__FJ898459__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaaggugcagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18028 - RNA, 9873 nt, Artificial Sequence
  derived and/or modified CDS sequence (opt4) from DENV-3__EU482555__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggaccuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18029 - RNA, 9873 nt, Artificial Sequence
  derived and/or modified CDS sequence (opt4) from DENV-3__EU529692__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggaccuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccguggugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18030 - RNA, 9873 nt, Artificial Sequence
  derived and/or modified CDS sequence (opt4) from DENV-3__EU482558__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacaccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18031 - RNA, 9873 nt, Artificial Sequence
  derived and/or modified CDS sequence (opt4) from DENV-3__EU482563__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18032 - RNA, 9873 nt, Artificial Sequence
  derived and/or modified CDS sequence (opt4) from DENV-3__EU529696__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggaccuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccguggugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18033 - RNA, 9873 nt, Artificial Sequence
  derived and/or modified CDS sequence (opt4) from DENV-3__EU529697__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugacccaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccugaacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18034 - RNA, 9873 nt, Artificial Sequence
  derived and/or modified CDS sequence (opt4) from DENV-3__EU482564__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggaccuggacuucaacuacugcgagggcaccaccguggugaucaccgagaacugcggcaccagaagacccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccguggugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18035 - RNA, 9873 nt, Artificial Sequence
  derived and/or modified CDS sequence (opt4) from DENV-3__EU529699__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccgugagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18036 - RNA, 9873 nt, Artificial Sequence
  derived and/or modified CDS sequence (opt4) from DENV-3__EU482566__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccaagggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18037 - RNA, 9873 nt, Artificial Sequence
  derived and/or modified CDS sequence (opt4) from DENV-3__EU529702__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacgugggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaaggugcccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucagcaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgcccugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggacccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18038 - RNA, 9873 nt, Artificial Sequence
  derived and/or modified CDS sequence (opt4) from DENV-3__EU529703__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagagccaccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18039 - RNA, 9873 nt, Artificial Sequence
  derived and/or modified CDS sequence (opt4) from DENV-3__EU529705__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcaucggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcugggccugaagggcaugagcuacgccaugugcaccaacaccuucgugcugaagaaggaggugagcgagacccagcacggcaccauccugaucaagguggaguacaagggcgaggacgugcccugcaaggugcccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaaggccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18040 - RNA, 9873 nt, Artificial Sequence
  derived and/or modified CDS sequence (opt4) from DENV-3__EU596492__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccugaacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaugccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18041 - RNA, 9873 nt, Artificial Sequence
  derived and/or modified CDS sequence (opt4) from DENV-3__EU596493__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18042 - RNA, 9873 nt, Artificial Sequence
  derived and/or modified CDS sequence (opt4) from DENV-3__EU596494__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcagcaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccagaagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18043 - RNA, 9873 nt, Artificial Sequence
  derived and/or modified CDS sequence (opt4) from DENV-3__EU687218__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagaaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18044 - RNA, 9873 nt, Artificial Sequence
  derived and/or modified CDS sequence (opt4) from DENV-3__EU726772__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaagggcagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18045 - RNA, 9873 nt, Artificial Sequence
  derived and/or modified CDS sequence (opt4) from DENV-3__FJ182013__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacgugggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18046 - RNA, 9873 nt, Artificial Sequence
  derived and/or modified CDS sequence (opt4) from DENV-3__EU781136__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18047 - RNA, 9873 nt, Artificial Sequence
  derived and/or modified CDS sequence (opt4) from DENV-3__EU781137__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcuggugaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18048 - RNA, 9873 nt, Artificial Sequence
  derived and/or modified CDS sequence (opt4) from DENV-3__EU726773__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18049 - RNA, 9873 nt, Artificial Sequence
  derived and/or modified CDS sequence (opt4) from DENV-3__EU726774__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucauggugggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18050 - RNA, 9873 nt, Artificial Sequence
  derived and/or modified CDS sequence (opt4) from DENV-3__EU687219__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcgugaucaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18051 - RNA, 9873 nt, Artificial Sequence
  derived and/or modified CDS sequence (opt4) from DENV-3__EU726768__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18052 - RNA, 9873 nt, Artificial Sequence
  derived and/or modified CDS sequence (opt4) from DENV-3__EU687226__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccgugagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcacaagcagacccagagaagcggcgugcccugggacgugcccagcccccccgagacccagaaggccgagcuggaggagggcguguacagaaucaagcagcagggcaucuucggcaagacccaggugggcgugggcgugcagaaggagggcguguuccacagcauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18053 - RNA, 9876 nt, Artificial Sequence
  derived and/or modified CDS sequence (opt4) from DENV-3__EU687233__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccugccacagcaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18054 - RNA, 9873 nt, Artificial Sequence
  derived and/or modified CDS sequence (opt4) from DENV-3__EU687234__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaaggugcccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18055 - RNA, 9873 nt, Artificial Sequence
  derived and/or modified CDS sequence (opt4) from DENV-3__EU687196__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugaucuucaccuucgugcugcugcugagcggccagaucaccuggagagacguggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaugagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccgugagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaucagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagcuucagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18056 - RNA, 9873 nt, Artificial Sequence
  derived and/or modified CDS sequence (opt4) from DENV-3__EU854298__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagaggugcacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcuggccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccauccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccaccaggugagaagccugaucggcaacgaggaguuccuggacuacaugcccagcaugaagagauucagaaaggaggaggagcuggagggcgccaucugguga

SEQ ID NO: 18057 - RNA, 9873 nt, Artificial Sequence
  derived and/or modified CDS sequence (opt4) from DENV-3__FJ373306__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacgugggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaaggugcccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucagcaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18058 - RNA, 9873 nt, Artificial Sequence
  derived and/or modified CDS sequence (opt4) from DENV-3__EU687197__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcuggccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcagaaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccaccaggugagaagccugaucggcaacgaggaguuccuggacuacaugcccagcaugaagagauucagaaaggaggaggagcuggagggcgccaucugguga

SEQ ID NO: 18059 - RNA, 9873 nt, Artificial Sequence
  derived and/or modified CDS sequence (opt4) from DENV-3__EU687198__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcgugggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18060 - RNA, 9873 nt, Artificial Sequence
  derived and/or modified CDS sequence (opt4) from DENV-3__EU726769__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugguggccggcguguucuucaccuucgugcugcugcugagcggccagaucaccuggagagacauggcccacacccugaucauggugggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggaucgccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaaggugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18061 - RNA, 9873 nt, Artificial Sequence
  derived and/or modified CDS sequence (opt4) from DENV-3__EU687239__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcgugggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccguggcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgugaucugguga

SEQ ID NO: 18062 - RNA, 9873 nt, Artificial Sequence
  derived and/or modified CDS sequence (opt4) from DENV-3__FJ182004__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18063 - RNA, 9873 nt, Artificial Sequence
  derived and/or modified CDS sequence (opt4) from DENV-3__FJ024465__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccuggccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacagccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18064 - RNA, 9873 nt, Artificial Sequence
  derived and/or modified CDS sequence (opt4) from DENV-3__FJ024466__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacagauuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgacaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccaccagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18065 - RNA, 9873 nt, Artificial Sequence
  derived and/or modified CDS sequence (opt4) from DENV-3__FJ024467__SS-prME
accagccugugccugaugauggugcugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccagacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggagaugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccgccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagccaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgagaacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18066 - RNA, 9873 nt, Artificial Sequence
  derived and/or modified CDS sequence (opt4) from DENV-3__FJ024468__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18067 - RNA, 9873 nt, Artificial Sequence
  derived and/or modified CDS sequence (opt4) from DENV-3__FJ024470__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagagccaccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18068 - RNA, 9873 nt, Artificial Sequence
  derived and/or modified CDS sequence (opt4) from DENV-3__FJ024471__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucaacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagagccaccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18069 - RNA, 9873 nt, Artificial Sequence
  derived and/or modified CDS sequence (opt4) from DENV-3__FJ182005__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaaggugcccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaaggccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18070 - RNA, 9873 nt, Artificial Sequence
  derived and/or modified CDS sequence (opt4) from DENV-3__FJ373302__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggccuacacccagcugugcgaccacagacugaugagcgccgccgugaaggacgagagagccgugcacgccgacaugggcuacuggaucgagagccagaagaagggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagcaagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18071 - RNA, 9873 nt, Artificial Sequence
  derived and/or modified CDS sequence (opt4) from DENV-3__FJ182007__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgaggacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggaucgccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18072 - RNA, 9873 nt, Artificial Sequence
  derived and/or modified CDS sequence (opt4) from DENV-3__FJ182008__SS-prME
accagccugugcaucaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucaucagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18073 - RNA, 9873 nt, Artificial Sequence
  derived and/or modified CDS sequence (opt4) from DENV-3__FJ182010__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccgacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18074 - RNA, 9873 nt, Artificial Sequence
  derived and/or modified CDS sequence (opt4) from DENV-3__FJ182011__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgacaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccaccagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18075 - RNA, 9873 nt, Artificial Sequence
  derived and/or modified CDS sequence (opt4) from DENV-3__FJ182038__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccacccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18076 - RNA, 9873 nt, Artificial Sequence
  derived and/or modified CDS sequence (opt4) from DENV-3__FJ182041__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcacccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18077 - RNA, 9873 nt, Artificial Sequence
  derived and/or modified CDS sequence (opt4) from DENV-3__FJ390371__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugaccaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18078 - RNA, 9873 nt, Artificial Sequence
  derived and/or modified CDS sequence (opt4) from DENV-3__FJ390372__SS-prME
accagccugugccugaugauggugcugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcgugaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccaccagagaguguucaaggagaagguggacaccagaacccccagaagcaugcccggccccagaagagccaugggcaucaccgccgaguggcuguggagaacccugggcagaaacaagaagcccagacugugcaccagagaggaguucaccaagaagggcagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgccaccgccggcugggacaccagaaucaccgaggacgaccugcacaacgaggagaagaucacccagcagauggaccccgaccacagacagcuggccaccgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18079 - RNA, 9873 nt, Artificial Sequence
  derived and/or modified CDS sequence (opt4) from DENV-3__FJ205870__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagcauccugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcccaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18080 - RNA, 9873 nt, Artificial Sequence
  derived and/or modified CDS sequence (opt4) from DENV-3__FJ390373__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggcagaggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgcccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18081 - RNA, 9873 nt, Artificial Sequence
  derived and/or modified CDS sequence (opt4) from DENV-3__FJ205871__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18082 - RNA, 9873 nt, Artificial Sequence
  derived and/or modified CDS sequence (opt4) from DENV-3__FJ390375__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18083 - RNA, 9873 nt, Artificial Sequence
  derived and/or modified CDS sequence (opt4) from DENV-3__FJ390376__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagagagaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaucuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18084 - RNA, 9873 nt, Artificial Sequence
  derived and/or modified CDS sequence (opt4) from DENV-3__FJ390377__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18085 - RNA, 9873 nt, Artificial Sequence
  derived and/or modified CDS sequence (opt4) from DENV-3__FJ547069__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaaccugggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18086 - RNA, 9873 nt, Artificial Sequence
  derived and/or modified CDS sequence (opt4) from DENV-3__FJ562107__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18087 - RNA, 9873 nt, Artificial Sequence
  derived and/or modified CDS sequence (opt4) from DENV-3__FJ547071__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaagaccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcugauccugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18088 - RNA, 9873 nt, Artificial Sequence
  derived and/or modified CDS sequence (opt4) from DENV-3__FJ410176__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggcagcagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18089 - RNA, 9873 nt, Artificial Sequence
  derived and/or modified CDS sequence (opt4) from DENV-3__FJ410177__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccggcggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18090 - RNA, 9873 nt, Artificial Sequence
  derived and/or modified CDS sequence (opt4) from DENV-3__FJ547072__SS-prME
accagccugugccugaugaugauccugcccgccgcccuggccuuccaccugaccagcagagacggcgagcccagaaugaucgugggcaagaacgagagaggcagaagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18091 - RNA, 9873 nt, Artificial Sequence
  derived and/or modified CDS sequence (opt4) from DENV-3__FJ547073__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagauacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18092 - RNA, 9873 nt, Artificial Sequence
  derived and/or modified CDS sequence (opt4) from DENV-3__FJ547074__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugaccuacagaagacccaccaucgagaaggacguggugcugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18093 - RNA, 9873 nt, Artificial Sequence
  derived and/or modified CDS sequence (opt4) from DENV-3__FJ547075__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagagcgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18094 - RNA, 9873 nt, Artificial Sequence
  derived and/or modified CDS sequence (opt4) from DENV-3__FJ547076__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccgugagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18095 - RNA, 9873 nt, Artificial Sequence
  derived and/or modified CDS sequence (opt4) from DENV-3__FJ547077__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggaaccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18096 - RNA, 9873 nt, Artificial Sequence
  derived and/or modified CDS sequence (opt4) from DENV-3__FJ547078__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggaucgacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccaagagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18097 - RNA, 9873 nt, Artificial Sequence
  derived and/or modified CDS sequence (opt4) from DENV-3__FJ547079__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcacaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18098 - RNA, 9873 nt, Artificial Sequence
  derived and/or modified CDS sequence (opt4) from DENV-3__FJ547080__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaaccccagaaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18099 - RNA, 9873 nt, Artificial Sequence
  derived and/or modified CDS sequence (opt4) from DENV-3__FJ547081__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucagcggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacgccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagcagcaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacagccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18100 - RNA, 9873 nt, Artificial Sequence
  derived and/or modified CDS sequence (opt4) from DENV-3__FJ547082__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagauguggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18101 - RNA, 9873 nt, Artificial Sequence
  derived and/or modified CDS sequence (opt4) from DENV-3__FJ547083__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagagcuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcagcgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18102 - RNA, 9873 nt, Artificial Sequence
  derived and/or modified CDS sequence (opt4) from DENV-3__FJ547084__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagagaggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaccacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18103 - RNA, 9873 nt, Artificial Sequence
  derived and/or modified CDS sequence (opt4) from DENV-3__FJ478456__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagcauccugcccgugugccagagcagcagcaugagaaagagcgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccagaagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18104 - RNA, 9873 nt, Artificial Sequence
  derived and/or modified CDS sequence (opt4) from DENV-3__FJ547085__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccaccgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcaccgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18105 - RNA, 9873 nt, Artificial Sequence
  derived and/or modified CDS sequence (opt4) from DENV-3__EU482595__SS-prME
accagccugugccugaugaugaugcugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacgugggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaaggugcccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaauccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucagcaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccgcccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggauccugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18106 - RNA, 9873 nt, Artificial Sequence
  derived and/or modified CDS sequence (opt4) from DENV-3__EU482596__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18107 - RNA, 9873 nt, Artificial Sequence
  derived and/or modified CDS sequence (opt4) from DENV-3__JQ922554__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagcuggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccagccaggccagcaccgccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccaagacccccaccuggaacagaaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacagaaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcauggccuucagcugcaucgccaucggcaucaucacccuguacgugggcgugguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaccggcgugcuggagcagggcgagagaacccugaccccccagcccauggagcugaaguacagcuggaagaccuggggcaaggccaagaucgugaccgccgagacccagaacagcagcuucaucaucgacggccccagcacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucagcgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggccagcgccggcagcggcaagguggacaacuucaccaugggcgugcugugccuggccauccuguucgaggaggugaugagaggcaaguucagaaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccgccacccugagacugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccagugggccaagggcggcgagacccaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcuggacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagaggcagcaacuacaaccugaucaucauggacgaggcccacuucaccgaccccgccagcaucgccgccaucggcuacaucagcaccagagugggcaugggcgaggccgccgccaucuucaugaccgccaccccccccggcaccguggacgccuucccccagagcaucccccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucuaccugagaagaugccugaagcccgugauccugaccaacggccccgagagagugauccuggccggccccaugcccgugaccguggccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaacuggagacccagauggcuggacgccagaaccuacagcgacccccuggcccugaaggaguucaaggacuucgccgccggcagaaagagcaucgcccuggaccuggugaccgagaucggcagagugcccagccaccuggcccacaccgugagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccacccccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccuggccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcuggccccugugcgaggugcuggcccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacaugguguuccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccugggugaagaacaaccaguucugcaucaaggugcugaaccccuacaugcccagcgugaucgagcaccuggagaaccugcagagaaagcacggcggcauccuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaaggacagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggccagagagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccacccccuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugcugggcaaggccagaaucagccagggcgccggcuggagccugagagagaccgccugccugggcaaggccuacgcccagauguggacccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18108 - RNA, 9873 nt, Artificial Sequence
  derived and/or modified CDS sequence (opt4) from DENV-3__EU529683__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccaccgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18109 - RNA, 9873 nt, Artificial Sequence
  derived and/or modified CDS sequence (opt4) from DENV-3__EU529684__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagaagcuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaccgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggacgagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18110 - RNA, 9873 nt, Artificial Sequence
  derived and/or modified CDS sequence (opt4) from DENV-3__FJ182015__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18111 - RNA, 9873 nt, Artificial Sequence
  derived and/or modified CDS sequence (opt4) from DENV-3__EU569688__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgaggccgagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagagaugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18112 - RNA, 9873 nt, Artificial Sequence
  derived and/or modified CDS sequence (opt4) from DENV-3__EU529686__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgagaacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacagccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18113 - RNA, 9873 nt, Artificial Sequence
  derived and/or modified CDS sequence (opt4) from DENV-3__EU529687__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18114 - RNA, 9873 nt, Artificial Sequence
  derived and/or modified CDS sequence (opt4) from DENV-3__KF955449__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18115 - RNA, 9873 nt, Artificial Sequence
  derived and/or modified CDS sequence (opt4) from DENV-3__FJ373303__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacgugaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacguggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18116 - RNA, 9873 nt, Artificial Sequence
  derived and/or modified CDS sequence (opt4) from DENV-3__KF955451__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcgugggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgugguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacguggagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaagcgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18117 - RNA, 9873 nt, Artificial Sequence
  derived and/or modified CDS sequence (opt4) from DENV-3__KF955453__SS-prME
accagccugugccugaugaugauccugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugaucagccugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18118 - RNA, 9873 nt, Artificial Sequence
  derived and/or modified CDS sequence (opt4) from DENV-3__FJ373304__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagguggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucauccuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18119 - RNA, 9873 nt, Artificial Sequence
  derived and/or modified CDS sequence (opt4) from DENV-3__EU854291__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccaucaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccgugagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggcagcgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18120 - RNA, 9873 nt, Artificial Sequence
  derived and/or modified CDS sequence (opt4) from DENV-3__KF955454__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagggcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuuccuggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagagccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccacccccccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18121 - RNA, 9873 nt, Artificial Sequence
  derived and/or modified CDS sequence (opt4) from DENV-3__EU854292__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcaucggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccgccagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucugccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccacaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18122 - RNA, 9873 nt, Artificial Sequence
  derived and/or modified CDS sequence (opt4) from DENV-3__FJ639746__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18123 - RNA, 9873 nt, Artificial Sequence
  derived and/or modified CDS sequence (opt4) from DENV-3__FJ639750__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18124 - RNA, 9873 nt, Artificial Sequence
  derived and/or modified CDS sequence (opt4) from DENV-3__FJ639754__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcaacuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18125 - RNA, 9873 nt, Artificial Sequence
  derived and/or modified CDS sequence (opt4) from DENV-3__FJ639757__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacagcgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18126 - RNA, 9873 nt, Artificial Sequence
  derived and/or modified CDS sequence (opt4) from DENV-3__FJ639758__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcagaugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18127 - RNA, 9873 nt, Artificial Sequence
  derived and/or modified CDS sequence (opt4) from DENV-3__FJ639759__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggauccccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccagcgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18128 - RNA, 9873 nt, Artificial Sequence
  derived and/or modified CDS sequence (opt4) from DENV-3__FJ639761__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccugcagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgugaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggccugcagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18129 - RNA, 9873 nt, Artificial Sequence
  derived and/or modified CDS sequence (opt4) from DENV-3__FJ639762__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagaucgaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcaucuucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18130 - RNA, 9873 nt, Artificial Sequence
  derived and/or modified CDS sequence (opt4) from DENV-3__FJ639763__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaacggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18131 - RNA, 9873 nt, Artificial Sequence
  derived and/or modified CDS sequence (opt4) from DENV-3__FJ639765__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucauccuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18132 - RNA, 9873 nt, Artificial Sequence
  derived and/or modified CDS sequence (opt4) from DENV-3__FJ639766__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18133 - RNA, 9873 nt, Artificial Sequence
  derived and/or modified CDS sequence (opt4) from DENV-3__FJ639767__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaucagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18134 - RNA, 9873 nt, Artificial Sequence
  derived and/or modified CDS sequence (opt4) from DENV-3__FJ639768__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccauccccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuacaucgccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18135 - RNA, 9873 nt, Artificial Sequence
  derived and/or modified CDS sequence (opt4) from DENV-3__FJ639769__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18136 - RNA, 9873 nt, Artificial Sequence
  derived and/or modified CDS sequence (opt4) from DENV-3__FJ882577__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcaucuucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18137 - RNA, 9873 nt, Artificial Sequence
  derived and/or modified CDS sequence (opt4) from DENV-3__FJ850096__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggccugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucaccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18138 - RNA, 9873 nt, Artificial Sequence
  derived and/or modified CDS sequence (opt4) from DENV-3__FJ882578__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaauccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18139 - RNA, 9873 nt, Artificial Sequence
  derived and/or modified CDS sequence (opt4) from DENV-3__FJ639770__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugacccugcagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18140 - RNA, 9873 nt, Artificial Sequence
  derived and/or modified CDS sequence (opt4) from DENV-3__FJ639771__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugagagagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggccugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18141 - RNA, 9873 nt, Artificial Sequence
  derived and/or modified CDS sequence (opt4) from DENV-3__FJ639772__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggauccccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccagcgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18142 - RNA, 9873 nt, Artificial Sequence
  derived and/or modified CDS sequence (opt4) from DENV-3__FJ639774__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcaccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18143 - RNA, 9873 nt, Artificial Sequence
  derived and/or modified CDS sequence (opt4) from DENV-3__FJ639775__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagccaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18144 - RNA, 9873 nt, Artificial Sequence
  derived and/or modified CDS sequence (opt4) from DENV-3__FJ639777__SS-prME
accagccugugccugaugaugacccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucguggccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaagcugggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccauccccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuacaucgccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugacccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaagcccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacagacugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18145 - RNA, 9873 nt, Artificial Sequence
  derived and/or modified CDS sequence (opt4) from DENV-3__FJ639778__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcagaaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacauggugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugaagaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugagaagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18146 - RNA, 9873 nt, Artificial Sequence
  derived and/or modified CDS sequence (opt4) from DENV-3__FJ639779__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagagaaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacuucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccgcccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccgccaugaagagauucagaaaggaggaggagagcgagggcgccaucugguga

SEQ ID NO: 18147 - RNA, 9873 nt, Artificial Sequence
  derived and/or modified CDS sequence (opt4) from DENV-3__FJ639780__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcaccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcauccccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18148 - RNA, 9873 nt, Artificial Sequence
  derived and/or modified CDS sequence (opt4) from DENV-3__FJ639781__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccaguacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaucagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgcccugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18149 - RNA, 9873 nt, Artificial Sequence
  derived and/or modified CDS sequence (opt4) from DENV-3__FJ639782__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18150 - RNA, 9873 nt, Artificial Sequence
  derived and/or modified CDS sequence (opt4) from DENV-3__FJ639785__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18151 - RNA, 9873 nt, Artificial Sequence
  derived and/or modified CDS sequence (opt4) from DENV-3__FJ639786__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccugggccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaagaccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacaucagcaccgccauccagcaggugagaagccugaucggcaacgaggaguuccuggacuacaugcccagcaugaagagauucagaaaggaggaggagagcgagggcgccaucugguga

SEQ ID NO: 18152 - RNA, 9873 nt, Artificial Sequence
  derived and/or modified CDS sequence (opt4) from DENV-3__FJ639787__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggcugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18153 - RNA, 9873 nt, Artificial Sequence
  derived and/or modified CDS sequence (opt4) from DENV-3__FJ639790__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccgccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18154 - RNA, 9873 nt, Artificial Sequence
  derived and/or modified CDS sequence (opt4) from DENV-3__FJ639791__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccguggagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaucagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcagcggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18155 - RNA, 9873 nt, Artificial Sequence
  derived and/or modified CDS sequence (opt4) from DENV-3__FJ639792__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagagagaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18156 - RNA, 9873 nt, Artificial Sequence
  derived and/or modified CDS sequence (opt4) from DENV-3__FJ639793__SS-prME
accagccugugccugaugaugauccugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaccagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcgugaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18157 - RNA, 9873 nt, Artificial Sequence
  derived and/or modified CDS sequence (opt4) from DENV-3__FJ639795__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcaucaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugcugaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18158 - RNA, 9873 nt, Artificial Sequence
  derived and/or modified CDS sequence (opt4) from DENV-3__FJ639798__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccguggagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacaucaacgccgagcccgagacccccaacauggacgugaucggcgagagaaucaagagaaucaaggaggagcacaacagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18159 - RNA, 9873 nt, Artificial Sequence
  derived and/or modified CDS sequence (opt4) from DENV-3__FJ639799__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcagagagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18160 - RNA, 9873 nt, Artificial Sequence
  derived and/or modified CDS sequence (opt4) from DENV-3__FJ639800__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgaggugcagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugagaaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcagcggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18161 - RNA, 9873 nt, Artificial Sequence
  derived and/or modified CDS sequence (opt4) from DENV-3__FJ639801__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccugcaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagagacugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18162 - RNA, 9873 nt, Artificial Sequence
  derived and/or modified CDS sequence (opt4) from DENV-3__KF955471__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcagcggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18163 - RNA, 9873 nt, Artificial Sequence
  derived and/or modified CDS sequence (opt4) from DENV-3__FJ639803__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcagcggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18164 - RNA, 9873 nt, Artificial Sequence
  derived and/or modified CDS sequence (opt4) from DENV-3__FJ639804__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagagccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucgagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaauccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugagaagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18165 - RNA, 9873 nt, Artificial Sequence
  derived and/or modified CDS sequence (opt4) from DENV-3__FJ639805__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugagaagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggccugggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18166 - RNA, 9873 nt, Artificial Sequence
  derived and/or modified CDS sequence (opt4) from DENV-3__FJ639807__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagagacugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18167 - RNA, 9873 nt, Artificial Sequence
  derived and/or modified CDS sequence (opt4) from DENV-3__FJ639810__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucugccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucaugcccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccuguacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18168 - RNA, 9873 nt, Artificial Sequence
  derived and/or modified CDS sequence (opt4) from DENV-3__FJ639816__SS-prME
accagccugugccugaugaugauccugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacgagcagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcgugaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18169 - RNA, 9873 nt, Artificial Sequence
  derived and/or modified CDS sequence (opt4) from DENV-3__FJ639817__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcagaaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcagagagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18170 - RNA, 9873 nt, Artificial Sequence
  derived and/or modified CDS sequence (opt4) from DENV-3__FJ639825__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggacuacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcagugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacaagcagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18171 - RNA, 9873 nt, Artificial Sequence
  derived and/or modified CDS sequence (opt4) from DENV-3__FJ639826__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccaccgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucaccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18172 - RNA, 9873 nt, Artificial Sequence
  derived and/or modified CDS sequence (opt4) from DENV-3__FJ810416__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccugaugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18173 - RNA, 9873 nt, Artificial Sequence
  derived and/or modified CDS sequence (opt4) from DENV-3__GQ252678__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacaucagcaccgccauccagcaggugagaagccugaucggcaacgaggaguuccuggacuacaugcccagcaugaagagauucagaaaggaggaggagagcgagggcgccaucugguga

SEQ ID NO: 18174 - RNA, 9873 nt, Artificial Sequence
  derived and/or modified CDS sequence (opt4) from DENV-3__FJ850098__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggaccccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugacccugcagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18175 - RNA, 9873 nt, Artificial Sequence
  derived and/or modified CDS sequence (opt4) from DENV-3__KF955479__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaucgugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18176 - RNA, 9873 nt, Artificial Sequence
  derived and/or modified CDS sequence (opt4) from DENV-3__FJ850109__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaccggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacagccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccaccgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18177 - RNA, 9873 nt, Artificial Sequence
  derived and/or modified CDS sequence (opt4) from DENV-3__GQ868586__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggacuacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcagugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgaggugacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggagagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacaagcagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccuggccaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18178 - RNA, 9873 nt, Artificial Sequence
  derived and/or modified CDS sequence (opt4) from DENV-3__FJ850110__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccaccgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18179 - RNA, 9873 nt, Artificial Sequence
  derived and/or modified CDS sequence (opt4) from DENV-3__FJ850111__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacagccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccaacaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccaccgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18180 - RNA, 9873 nt, Artificial Sequence
  derived and/or modified CDS sequence (opt4) from DENV-3__KF955486__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18181 - RNA, 9873 nt, Artificial Sequence
  derived and/or modified CDS sequence (opt4) from DENV-3__FJ898468__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18182 - RNA, 9873 nt, Artificial Sequence
  derived and/or modified CDS sequence (opt4) from DENV-3__FJ898469__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggccugcagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18183 - RNA, 9873 nt, Artificial Sequence
  derived and/or modified CDS sequence (opt4) from DENV-3__FJ898470__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccgccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18184 - RNA, 9873 nt, Artificial Sequence
  derived and/or modified CDS sequence (opt4) from DENV-3__FJ898471__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18185 - RNA, 9873 nt, Artificial Sequence
  derived and/or modified CDS sequence (opt4) from DENV-3__FJ898472__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18186 - RNA, 9873 nt, Artificial Sequence
  derived and/or modified CDS sequence (opt4) from DENV-3__FJ898474__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgcccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucaugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccaucaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagggccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaucggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaucaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagagcccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18187 - RNA, 9873 nt, Artificial Sequence
  derived and/or modified CDS sequence (opt4) from DENV-3__EU529688__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18188 - RNA, 9873 nt, Artificial Sequence
  derived and/or modified CDS sequence (opt4) from DENV-3__EU482613__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18189 - RNA, 9873 nt, Artificial Sequence
  derived and/or modified CDS sequence (opt4) from DENV-3__EU529690__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18190 - RNA, 9873 nt, Artificial Sequence
  derived and/or modified CDS sequence (opt4) from DENV-3__EU529691__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccgugggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18191 - RNA, 9873 nt, Artificial Sequence
  derived and/or modified CDS sequence (opt4) from DENV-3__EU569689__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaaggccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagaccuggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18192 - RNA, 9873 nt, Artificial Sequence
  derived and/or modified CDS sequence (opt4) from DENV-3__EU482614__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18193 - RNA, 9873 nt, Artificial Sequence
  derived and/or modified CDS sequence (opt4) from DENV-3__EU569690__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggagcagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacgagcagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaucccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18194 - RNA, 9873 nt, Artificial Sequence
  derived and/or modified CDS sequence (opt4) from DENV-3__EU569691__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucacccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacagaaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18195 - RNA, 9873 nt, Artificial Sequence
  derived and/or modified CDS sequence (opt4) from DENV-3__EU482452__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccuggacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccugaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugagcccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18196 - RNA, 9873 nt, Artificial Sequence
  derived and/or modified CDS sequence (opt4) from DENV-3__EU482453__SS-prME
accagccugugccugaucaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaccaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagcuggagggcgccaucugguga

SEQ ID NO: 18197 - RNA, 9873 nt, Artificial Sequence
  derived and/or modified CDS sequence (opt4) from DENV-3__EU482454__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccaagggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccuggguggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagagagagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaagagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaugggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagagaaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgcccacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18198 - RNA, 9873 nt, Artificial Sequence
  derived and/or modified CDS sequence (opt4) from DENV-3__EU482455__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugguggccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgccuucgaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaucggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18199 - RNA, 9873 nt, Artificial Sequence
  derived and/or modified CDS sequence (opt4) from DENV-3__EU482456__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaccgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18200 - RNA, 9873 nt, Artificial Sequence
  derived and/or modified CDS sequence (opt4) from DENV-3__EU482457__SS-prME
accagcuucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcauccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacagacuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugauggugaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucggccccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacaacgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18201 - RNA, 9873 nt, Artificial Sequence
  derived and/or modified CDS sequence (opt4) from DENV-3__EU482458__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcugaccaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaugagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccaucaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18202 - RNA, 9873 nt, Artificial Sequence
  derived and/or modified CDS sequence (opt4) from DENV-3__EU482459__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18203 - RNA, 9873 nt, Artificial Sequence
  derived and/or modified CDS sequence (opt4) from DENV-3__EU482460__SS-prME
accagccugugccugaugaugaugcugcccgccaccuucgccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcaccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacagauuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagagcccuggccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaugggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgaccccaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18204 - RNA, 9873 nt, Artificial Sequence
  derived and/or modified CDS sequence (opt4) from DENV-3__EU482461__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18205 - RNA, 9873 nt, Artificial Sequence
  derived and/or modified CDS sequence (opt4) from DENV-3__EU482462__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccagaaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggaccugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggaaggacauggcccacaccuucaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccuggugcuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaucagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18206 - RNA, 9873 nt, Artificial Sequence
  derived and/or modified CDS sequence (opt4) from DENV-3__EU660407__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagaacgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagagagugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18207 - RNA, 9873 nt, Artificial Sequence
  derived and/or modified CDS sequence (opt4) from DENV-3__EU660409__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccaccagacuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgacacccagggcgccaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgcccugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccauggccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaagguggccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaccgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18208 - RNA, 9873 nt, Artificial Sequence
  derived and/or modified CDS sequence (opt4) from DENV-3__EU660410__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccagaaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacaccuucaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccuggugcuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgccccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaucagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18209 - RNA, 9873 nt, Artificial Sequence
  derived and/or modified CDS sequence (opt4) from DENV-3__EU660411__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaucaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18210 - RNA, 9873 nt, Artificial Sequence
  derived and/or modified CDS sequence (opt4) from DENV-3__FJ432722__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgugaucugguga

SEQ ID NO: 18211 - RNA, 9873 nt, Artificial Sequence
  derived and/or modified CDS sequence (opt4) from DENV-3__FJ432728__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgaggacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18212 - RNA, 9873 nt, Artificial Sequence
  derived and/or modified CDS sequence (opt4) from DENV-3__FJ432731__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggcccagacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccaugaccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18213 - RNA, 9873 nt, Artificial Sequence
  derived and/or modified CDS sequence (opt4) from DENV-3__FJ562097__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccgccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18214 - RNA, 9873 nt, Artificial Sequence
  derived and/or modified CDS sequence (opt4) from DENV-3__FJ432741__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccgugguggccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggugcacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacauggugauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagguguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagaaagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18215 - RNA, 9873 nt, Artificial Sequence
  derived and/or modified CDS sequence (opt4) from DENV-3__FJ562099__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18216 - RNA, 9873 nt, Artificial Sequence
  derived and/or modified CDS sequence (opt4) from DENV-3__KF955457__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgccaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacuucagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgaggacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggacagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18217 - RNA, 9873 nt, Artificial Sequence
  derived and/or modified CDS sequence (opt4) from DENV-3__FJ562100__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaccgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18218 - RNA, 9873 nt, Artificial Sequence
  derived and/or modified CDS sequence (opt4) from DENV-3__FJ547062__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucagcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18219 - RNA, 9873 nt, Artificial Sequence
  derived and/or modified CDS sequence (opt4) from DENV-3__FJ461322__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgaggugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacauccccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18220 - RNA, 9873 nt, Artificial Sequence
  derived and/or modified CDS sequence (opt4) from DENV-3__KF955458__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggugaacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccugaugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18221 - RNA, 9873 nt, Artificial Sequence
  derived and/or modified CDS sequence (opt4) from DENV-3__FJ562102__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacaccuucaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18222 - RNA, 9873 nt, Artificial Sequence
  derived and/or modified CDS sequence (opt4) from DENV-3__FJ410229__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18223 - RNA, 9873 nt, Artificial Sequence
  derived and/or modified CDS sequence (opt4) from DENV-3__FJ461326__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucagcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccagaaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaaagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18224 - RNA, 9873 nt, Artificial Sequence
  derived and/or modified CDS sequence (opt4) from DENV-3__FJ461329__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgaggacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18225 - RNA, 9873 nt, Artificial Sequence
  derived and/or modified CDS sequence (opt4) from DENV-3__KF955459__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcgccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18226 - RNA, 9873 nt, Artificial Sequence
  derived and/or modified CDS sequence (opt4) from DENV-3__FJ547066__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagauggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgagggcuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18227 - RNA, 9873 nt, Artificial Sequence
  derived and/or modified CDS sequence (opt4) from DENV-3__KF955460__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcaacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagaaggacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacauccccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18228 - RNA, 9873 nt, Artificial Sequence
  derived and/or modified CDS sequence (opt4) from DENV-3__FJ461334__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucauccuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18229 - RNA, 9873 nt, Artificial Sequence
  derived and/or modified CDS sequence (opt4) from DENV-3__FJ461337__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcaugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgaggacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccgccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18230 - RNA, 9873 nt, Artificial Sequence
  derived and/or modified CDS sequence (opt4) from DENV-3__FJ461338__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugguggccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18231 - RNA, 9873 nt, Artificial Sequence
  derived and/or modified CDS sequence (opt4) from DENV-3__FJ562103__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacagaugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcaacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagaaggacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacauccccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18232 - RNA, 9873 nt, Artificial Sequence
  derived and/or modified CDS sequence (opt4) from DENV-3__FJ898456__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccaucuucuucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccagccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagagcuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucaacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggagagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaagacuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18233 - RNA, 9873 nt, Artificial Sequence
  derived and/or modified CDS sequence (opt4) from DENV-3__JN697379__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccagccaggccagcaccgccgaggugauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcugaagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacagaaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgugguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaccggcgugcuggagcagggcaagagaacccugaccccccagcccauggagcugaaguacagcuggaagaccuggggcaaggccaagaucgugaccgccgagacccagaacagcagcuucaucaucgacggccccagcacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucagcgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgugagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccgccacccugagacugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccuggccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggugcugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccacccccuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggacccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18234 - RNA, 9873 nt, Artificial Sequence
  derived and/or modified CDS sequence (opt4) from DENV-3__JQ045687__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugguggccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaccauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18235 - RNA, 9873 nt, Artificial Sequence
  derived and/or modified CDS sequence (opt4) from DENV-3__JQ045689__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacaguucgagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugacccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacauccccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18236 - RNA, 9873 nt, Artificial Sequence
  derived and/or modified CDS sequence (opt4) from DENV-3__JQ045691__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacaucggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaucagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagaagagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugcugagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagcagcaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagagccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacagccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18237 - RNA, 9873 nt, Artificial Sequence
  derived and/or modified CDS sequence (opt4) from DENV-3__JQ045692__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaucagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgaggcccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagaccuuccugcugcugggccugaugauccugcugaccggcggcgccaugcuguuccugcugagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcaaggacguguucuaccugccccccgagaagugcgacacccugcugugcgacaucggcgagagcagccccagcagcaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagagccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18238 - RNA, 9873 nt, Artificial Sequence
  derived and/or modified CDS sequence (opt4) from DENV-3__JQ045694__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaugagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcccccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaaccuggugaagcugaugagcggcagagacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccgagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18239 - RNA, 9873 nt, Artificial Sequence
  derived and/or modified CDS sequence (opt4) from DENV-3__GU363549__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacgagcagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccaccauccagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugagacacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcacccacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagaugaaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacaucagcaccgccauccagcaggugagaagccugaucggcaacgaggaguuccuggacuacaugcccagcaugaagagauucagaaaggaggaggagagcgagggcgccaucugguga

SEQ ID NO: 18240 - RNA, 9873 nt, Artificial Sequence
  derived and/or modified CDS sequence (opt4) from DENV-3__KJ622197__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcaacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18241 - RNA, 9873 nt, Artificial Sequence
  derived and/or modified CDS sequence (opt4) from DENV-3__KJ622198__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcaacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagccugcccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18242 - RNA, 9873 nt, Artificial Sequence
  derived and/or modified CDS sequence (opt4) from DENV-3__KJ622191__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgaggugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaugggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18243 - RNA, 9873 nt, Artificial Sequence
  derived and/or modified CDS sequence (opt4) from DENV-3__KJ622192__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18244 - RNA, 9873 nt, Artificial Sequence
  derived and/or modified CDS sequence (opt4) from DENV-3__KJ622193__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcagggcgugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18245 - RNA, 9873 nt, Artificial Sequence
  derived and/or modified CDS sequence (opt4) from DENV-3__KJ622194__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacagcggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacgccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18246 - RNA, 9873 nt, Artificial Sequence
  derived and/or modified CDS sequence (opt4) from DENV-3__KJ622195__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucgacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcaacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18247 - RNA, 9873 nt, Artificial Sequence
  derived and/or modified CDS sequence (opt4) from DENV-3__KJ622196__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcugcugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcaacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccacauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18248 - RNA, 9873 nt, Artificial Sequence
  derived and/or modified CDS sequence (opt4) from DENV-3__KJ830751__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccugggccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagagcugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguacgaggaggugaugagaggcaaguucggcaagaagcacaugaucgccggcguguucuucaccuucgugcugcugcugagcggccagaucaccuggagaaacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgacgacaucgagcagauggccaacggcaucgcccugggccugauggcccugaagcugaucacccaguucgagaccuaccagcuguggaccgcccuggugagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaucgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcauccugcccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgaggugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacaugguggugcccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucauccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugaccaaggccgaccuggagaacagccaccugcccgagaagaagaucacccaguggcuggagaccaagggcguggagagacugaagagaauggccaucagcggcgacgacugcguggugaagcccaucgacgacagauucgccaacgcccugguggcccugaacgacaugggcaaggugagaaaggacaucccccaguggcagcccagcagaggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggagaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18249 - RNA, 9873 nt, Artificial Sequence
  derived and/or modified CDS sequence (opt4) from DENV-3__KC762681__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggaccugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccauguucacccugaccguggccuggagaaccgccacccugauccuggccggcaucagccugcugcccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgcccacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaagaccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18250 - RNA, 9873 nt, Artificial Sequence
  derived and/or modified CDS sequence (opt4) from DENV-3__KC762684__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugagcaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagaugcagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccaucaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagagagaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcuggugacccaguucgagaccuaccagcuguggaccgcccuggugagccugaugugcagcaacaccaucuucacccugaccguggccuggagaaccgccacccugauccuggccggcaucagccugcugccccugugccagagcagcggcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccagcgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgugaugcuguuccugaucagcggcaagggcgugggcaagaccagcaucggccugaucugcgugguggccagcagcagcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18251 - RNA, 9873 nt, Artificial Sequence
  derived and/or modified CDS sequence (opt4) from DENV-3__KC762686__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccaccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgcccacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggagcccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18252 - RNA, 9873 nt, Artificial Sequence
  derived and/or modified CDS sequence (opt4) from DENV-3__KC762685__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcaccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgcccacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggagcccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18253 - RNA, 9873 nt, Artificial Sequence
  derived and/or modified CDS sequence (opt4) from DENV-3__KC762687__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccgugguggugaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccuguuccccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgugcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacaagaccagaagcgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18254 - RNA, 9873 nt, Artificial Sequence
  derived and/or modified CDS sequence (opt4) from DENV-3__KC762688__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacacccuguucacccugaccguggccuggagaaccgccacccugauccuggccggcaucagccugcugcccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgcccacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggaguuccccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagaagggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggaucgaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18255 - RNA, 9873 nt, Artificial Sequence
  derived and/or modified CDS sequence (opt4) from DENV-3__KC762689__SS-prME
accagccugugccugaugaugaugauccccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagagcugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugguggccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgaccuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgugcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagguggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18256 - RNA, 9873 nt, Artificial Sequence
  derived and/or modified CDS sequence (opt4) from DENV-3__KC762690__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggaguucaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccgugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgcccacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgaggagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggccauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuucagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggagcccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcuggagaaggagaucacccaguggcuggagaccaagggcguggagagacugaagagaauggccaucagcggcgacgacugcguggugaagcccaucgacgacagauucgccgacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccuggccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18257 - RNA, 9873 nt, Artificial Sequence
  derived and/or modified CDS sequence (opt4) from DENV-3__KC762691__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaaggacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacaccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccagaagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcgccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccuguuccccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagaaucggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18258 - RNA, 9873 nt, Artificial Sequence
  derived and/or modified CDS sequence (opt4) from DENV-3__KC762692__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgugggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggugcugaagcugaucacccaguucgagaccuaccagcuguggaccgcccuggugagccugaccugcagcaacaccaucuucacccugaccguggccuggagaaccgccacccugauccuggccggcaccagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaucaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccaccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaagaucauggagaucaccgccggcuggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcagggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaaccugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgagaacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18259 - RNA, 9873 nt, Artificial Sequence
  derived and/or modified CDS sequence (opt4) from DENV-3__JQ920481__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18260 - RNA, 9873 nt, Artificial Sequence
  derived and/or modified CDS sequence (opt4) from DENV-3__JQ920483__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcagaaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagagaaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18261 - RNA, 9873 nt, Artificial Sequence
  derived and/or modified CDS sequence (opt4) from DENV-3__JQ920482__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18262 - RNA, 9873 nt, Artificial Sequence
  derived and/or modified CDS sequence (opt4) from DENV-3__JQ920484__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18263 - RNA, 9873 nt, Artificial Sequence
  derived and/or modified CDS sequence (opt4) from DENV-3__JQ920486__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagaaguacacccagcugugcgaccacagacugaugagcgccgccgugaaggacgagagagccgugcacguggacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaucgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18264 - RNA, 9873 nt, Artificial Sequence
  derived and/or modified CDS sequence (opt4) from DENV-3__JQ920485__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagaagcacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccauccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaucgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacaugaacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagcccgagggcgccaucugguga

SEQ ID NO: 18265 - RNA, 9873 nt, Artificial Sequence
  derived and/or modified CDS sequence (opt4) from DENV-3__FJ644564__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccuggagaaccuggagcuggacuucaccuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcauccugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugagcgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcaguggcugguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcagcagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18266 - RNA, 9873 nt, Artificial Sequence
  derived and/or modified CDS sequence (opt4) from DENV-3__HQ235027__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaucgagauccagaacagcggcggcaccagcaucuucgccggccaccugaagugcagacugaagauggacaagcuggagcugaagggcaugagcuacgccaugugcaccaagaccuucgugcugaagaaggaggugagcgagacccagcacggcaccauccugaucaagguggaguacaagggcgaggacgcccccugcaagauccccuucagcaccgaggacggccagggcaaggccuacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaucagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugguggugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgacagauacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18267 - RNA, 9873 nt, Artificial Sequence
  derived and/or modified CDS sequence (opt4) from DENV-3__JQ920476__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagagcggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18268 - RNA, 9873 nt, Artificial Sequence
  derived and/or modified CDS sequence (opt4) from DENV-3__JQ920477__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucagcaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18269 - RNA, 9873 nt, Artificial Sequence
  derived and/or modified CDS sequence (opt4) from DENV-3__JQ920478__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcagaggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggaccuggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18270 - RNA, 9873 nt, Artificial Sequence
  derived and/or modified CDS sequence (opt4) from DENV-3__JQ920480__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgacuacggcacccugggccuggagugcagccccagaaccggccuggacuucaacgagaugauccugcugaccaugaagaacaaggccuggauggugcacagacagugguuccuggaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacgagagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucauguucgugcugcugcugagcggccagaucaccuggagagacauggugcacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18271 - RNA, 9873 nt, Artificial Sequence
  derived and/or modified CDS sequence (opt4) from DENV-3__JQ920479__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguuccuggaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacgagagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucauguucgugcugcugcugagcggccagaucaccuggagagacauggugcacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacagcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18272 - RNA, 9873 nt, Artificial Sequence
  derived and/or modified CDS sequence (opt4) from DENV-3__KU216208__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggaucgacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacgccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgagaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccauggccaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18273 - RNA, 9873 nt, Artificial Sequence
  derived and/or modified CDS sequence (opt4) from DENV-3__GU370053__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccugggccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagagcugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguacgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgaggugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacaugguggugcccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucauccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugaccaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcagaggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggagaaccccuggauggaggacaagacccccgugaccaccugggagaacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18274 - RNA, 9873 nt, Artificial Sequence
  derived and/or modified CDS sequence (opt4) from DENV-3__JQ411814__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcaucggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagacguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccauccugacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugaugggcaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagacaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18275 - RNA, 9873 nt, Artificial Sequence
  derived and/or modified CDS sequence (opt4) from DENV-3__KM190937__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggccaucgccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagaugcagggcgugaccgccgagaucaccccccaggccagcaccgccgaggugauccugcccgaguacggcacccugggccuggagugcagccccagaaccggccuggacuucaacgagaugaucagccugaccaugaagaacaaggccuggauggugcacagacagugguucuucgaccugccccugcccuggaccagcggcgccaccgccgagacccccaccuggaacagaaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugagcagcuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaccggcgugcuggagcagggcaagagaacccugaccccccagcccauggagcugaaguacagcuggaagaccuggggcaaggccaagaucgugaccgccgagacccagaacagcagcuucaucaucgacggccccagcacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucagcgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggccagcgccggcagcggcaagguggacaacuucaccaugggcgugcugugccuggccauccuguucgaggaggugaugagaggcaaguucggcaagauccacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccgccacccugagacugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgcccagccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugauggugaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccuggccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggugcugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccacccccuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18276 - RNA, 9873 nt, Artificial Sequence
  derived and/or modified CDS sequence (opt4) from DENV-3__JQ920487__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18277 - RNA, 9873 nt, Artificial Sequence
  derived and/or modified CDS sequence (opt4) from DENV-3__JQ920488__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacgagagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugggcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18278 - RNA, 9873 nt, Artificial Sequence
  derived and/or modified CDS sequence (opt4) from DENV-3__JQ920489__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagaaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaucagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagaccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccagagagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaucgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacaugaacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagccacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18279 - RNA, 9873 nt, Artificial Sequence
  derived and/or modified CDS sequence (opt4) from DENV-3__KF824902__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagagcccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagacccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgagggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggugcugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18280 - RNA, 9873 nt, Artificial Sequence
  derived and/or modified CDS sequence (opt4) from DENV-3__KF824903__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaccaucaccgugcacaccggcgaccagcaccaggugggcaacgacacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucggcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagagcccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagaccugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccguggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcagaaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccaggccaacgccgagcccgagggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggagugcaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaagagaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaccgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggagagcgccagagccgccguggaggacgaggaguucuggaagcuggugggcagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18281 - RNA, 9873 nt, Artificial Sequence
  derived and/or modified CDS sequence (opt4) from DENV-3__JF504679__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgugaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccgugagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagagagaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccaccauccagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagaugaaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18282 - RNA, 9873 nt, Artificial Sequence
  derived and/or modified CDS sequence (opt4) from DENV-3__KC425219__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaaccccaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18283 - RNA, 9873 nt, Artificial Sequence
  derived and/or modified CDS sequence (opt4) from DENV-3__AY858037__SS-prME
accagccugugccugaugaugaugcugcccgugacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacagagcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccuguuccccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18284 - RNA, 9873 nt, Artificial Sequence
  derived and/or modified CDS sequence (opt4) from DENV-3__KJ737429__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18285 - RNA, 9873 nt, Artificial Sequence
  derived and/or modified CDS sequence (opt4) from DENV-3__DQ863638__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugauccuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggcccccacacccccgagugccccagagccagcagagccuggaacgugugggagguggaggacuacggcuucggcguguucaccaccaacaucuggcugaagcugagagaggaguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggccagcgccggcagcggcaagguggacaacuucaccaugggcuuccugugccuggccauccuguucgaggaggugaugagaggcaaguucggcaagaagcacaugaucgccggcguguuccugaccuuccugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaacuuccugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucagaggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggccacccacuacgccaucaucggccccggccugcaggccaaggccaccagagaggcccagaagagaaccgccgccggcaucaccaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucaccagacacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuucuucaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagcagaggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucaagaaggaggaggagagcgagggcgccaucugguga

SEQ ID NO: 18286 - RNA, 9873 nt, Artificial Sequence
  derived and/or modified CDS sequence (opt4) from DENV-3__KJ737430__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgacacccagggcgugaccguggagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18287 - RNA, 9873 nt, Artificial Sequence
  derived and/or modified CDS sequence (opt4) from DENV-3__AY858040__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagaagcagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugaugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgccuacuggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccgugagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacccaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggagcccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgaggacgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18288 - RNA, 9873 nt, Artificial Sequence
  derived and/or modified CDS sequence (opt4) from DENV-3__AY858041__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggccaggcccacaacggcagacugaucaccgccaaccccguggugaccaagaaggaggagcccgugaacaucgaggccgagagccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgacgacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggaagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagcagcaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcagggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18289 - RNA, 9873 nt, Artificial Sequence
  derived and/or modified CDS sequence (opt4) from DENV-3__KC261634__SS-prME
accagcaucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacagacccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucagaguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggcccaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcgugcuguucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacgcccccaagaagagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcgccgugagcagcaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagagacugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccauggagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacagacugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaagacuggccagcgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggaggacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 18290 - RNA, 9873 nt, Artificial Sequence
  derived and/or modified CDS sequence (opt4) from DENV-3__JN662391__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacgagcagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucaugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccaccauccagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcacccacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagaugaaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacaucagcaccgccauccagcaggugagaagccugaucggcaacgaggaguuccuggacuacaugcccagcaugaagagauucagaaaggaggaggagagcgagggcgccaucugguga

SEQ ID NO: 18291 - RNA, 9873 nt, Artificial Sequence
  derived and/or modified CDS sequence (opt4) from DENV-3__AY858043__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacaggccgagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcagacacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggugcacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagguggugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggagaaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagaccuuccugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcagggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucauccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcagaggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18292 - RNA, 9873 nt, Artificial Sequence
  derived and/or modified CDS sequence (opt4) from DENV-3__AY858044__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccaucaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccggcuggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcagggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18293 - RNA, 9873 nt, Artificial Sequence
  derived and/or modified CDS sequence (opt4) from DENV-3__AY858045__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccaucaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgccaucuucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggccagaacccugaucaugaucggcagcaacgccagcgacagaaugggcaugggcgugaccuaccuggcccugaucgccaccuucgagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagagacugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccggcuggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcagggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18294 - RNA, 9873 nt, Artificial Sequence
  derived and/or modified CDS sequence (opt4) from DENV-3__AY858046__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccaucaccuacaagugcccccugaucaccgagguggagcccgaggacaucgacugcuggugcaaccugaccagcaccugggugaccuacggcaccugcaaccaggugggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucauguucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggcaugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugagaagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggccauggagaucaccgccggcuggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcagggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggugcagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18295 - RNA, 9873 nt, Artificial Sequence
  derived and/or modified CDS sequence (opt4) from DENV-3__AY858047__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacagccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugccccugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagagaacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgugaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggccagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaucguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18296 - RNA, 9873 nt, Artificial Sequence
  derived and/or modified CDS sequence (opt4) from DENV-3__HQ332170__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggacuacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcagugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaagcauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacaagcagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18297 - RNA, 9873 nt, Artificial Sequence
  derived and/or modified CDS sequence (opt4) from DENV-3__AY858038__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucagacugaccgugguggugggcgacaccaucggcgugcugcagcagggcaagagaacccugcccccccagcccauggagcugaaguacagcuggaagaccuggggcaaggccaagaucgugaccgccaagacccagaacagcagcuucaucaucgacggccccaacacccccgaguggcccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcuggugacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagagaaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18298 - RNA, 9873 nt, Artificial Sequence
  derived and/or modified CDS sequence (opt4) from DENV-3__AY858039__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaucuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugccccccagcccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagagaggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18299 - RNA, 9873 nt, Artificial Sequence
  derived and/or modified CDS sequence (opt4) from DENV-3__JN368477__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugacccaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccggccacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 18300 - RNA, 9873 nt, Artificial Sequence
  derived and/or modified CDS sequence (opt4) from DENV-3__EF643017__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucagcggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucacccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugagcccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccagagaggaggaggccgagcagaccggcgugagccacaaccugaugaccaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugagcuggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgugggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaccggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 18301 - RNA, 9873 nt, Artificial Sequence
  derived and/or modified CDS sequence (opt4) from DENV-3__DQ675519__SS-prME
accagcaucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcagaauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcguggcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccaucggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcauccagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccaccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggccuacagaaccagaagcgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccaaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagacccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 18302 - RNA, 9873 nt, Artificial Sequence
  derived and/or modified CDS sequence (opt4) from DENV-3__DQ675521__SS-prME
accagcuucugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagauguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucagagccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccagcgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga
